United States Patent 11,931,406 (FLAVIVIRUS VACCINE) - sequence listing, part 43

SEQ ID NO: 16140 - RNA, 9879 nt, Artificial Sequence
  derived and/or modified CDS sequence (opt4) from DENV-1__FJ639796__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16141 - RNA, 9879 nt, Artificial Sequence
  derived and/or modified CDS sequence (opt4) from DENV-1__FJ639797__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16142 - RNA, 9879 nt, Artificial Sequence
  derived and/or modified CDS sequence (opt4) from DENV-1__FJ639802__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacagauuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16143 - RNA, 9879 nt, Artificial Sequence
  derived and/or modified CDS sequence (opt4) from DENV-1__JN819410__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcaaccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16144 - RNA, 9879 nt, Artificial Sequence
  derived and/or modified CDS sequence (opt4) from DENV-1__FJ639806__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcugaagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16145 - RNA, 9879 nt, Artificial Sequence
  derived and/or modified CDS sequence (opt4) from DENV-1__JN819411__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagcugaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16146 - RNA, 9879 nt, Artificial Sequence
  derived and/or modified CDS sequence (opt4) from DENV-1__FJ639812__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagaugaugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugcugcuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16147 - RNA, 9879 nt, Artificial Sequence
  derived and/or modified CDS sequence (opt4) from DENV-1__FJ639813__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaugaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagcuucagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccaugcccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacagcgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16148 - RNA, 9879 nt, Artificial Sequence
  derived and/or modified CDS sequence (opt4) from DENV-1__JN819412__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugcugcuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16149 - RNA, 9879 nt, Artificial Sequence
  derived and/or modified CDS sequence (opt4) from DENV-1__FJ810415__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcgugaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugaacugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16150 - RNA, 9879 nt, Artificial Sequence
  derived and/or modified CDS sequence (opt4) from DENV-1__FJ639814__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16151 - RNA, 9879 nt, Artificial Sequence
  derived and/or modified CDS sequence (opt4) from DENV-1__FJ639815__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccaugcugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16152 - RNA, 9879 nt, Artificial Sequence
  derived and/or modified CDS sequence (opt4) from DENV-1__FJ639818__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacaccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggagaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccacccaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16153 - RNA, 9879 nt, Artificial Sequence
  derived and/or modified CDS sequence (opt4) from DENV-1__FJ639819__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacaacuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccugcgugaagaaggaccugaucagcuacggcggcggcuggagauuccagggccuguggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16154 - RNA, 9879 nt, Artificial Sequence
  derived and/or modified CDS sequence (opt4) from DENV-1__FJ639820__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggccaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16155 - RNA, 9879 nt, Artificial Sequence
  derived and/or modified CDS sequence (opt4) from DENV-1__FJ639821__SS-prME
agcgccaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugagauacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuacacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacaacuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacggcaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggacaaggccgccgaggugagcugggagcaggaggccgagcacagcggcgccagccacaacaucagcguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccugcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgugaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaaccacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacgugaccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16156 - RNA, 9879 nt, Artificial Sequence
  derived and/or modified CDS sequence (opt4) from DENV-1__FJ639824__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugguggccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16157 - RNA, 9879 nt, Artificial Sequence
  derived and/or modified CDS sequence (opt4) from DENV-1__JN819425__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgugaagaucagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16158 - RNA, 9879 nt, Artificial Sequence
  derived and/or modified CDS sequence (opt4) from DENV-1__FJ850099__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugagcagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16159 - RNA, 9879 nt, Artificial Sequence
  derived and/or modified CDS sequence (opt4) from DENV-1__FJ850100__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccacccaccuggcccugauggccaccuucaagaugagacccauguucgccgugggccugcuguucagaagacugaccagcagagaggugcugcugcugaccaucggccugagccugauggccagcauggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccaugauccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcacccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16160 - RNA, 9879 nt, Artificial Sequence
  derived and/or modified CDS sequence (opt4) from DENV-1__FJ882579__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugcugcuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16161 - RNA, 9879 nt, Artificial Sequence
  derived and/or modified CDS sequence (opt4) from DENV-1__JN819414__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggccuacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugcugcuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccggcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacaccgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16162 - RNA, 9879 nt, Artificial Sequence
  derived and/or modified CDS sequence (opt4) from DENV-1__FJ873810__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16163 - RNA, 9879 nt, Artificial Sequence
  derived and/or modified CDS sequence (opt4) from DENV-1__FJ850103__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagagagcaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16164 - RNA, 9879 nt, Artificial Sequence
  derived and/or modified CDS sequence (opt4) from DENV-1__FJ850104__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgugaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggaggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16165 - RNA, 9879 nt, Artificial Sequence
  derived and/or modified CDS sequence (opt4) from DENV-1__JN819405__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccacccaccuggcccugauggccaccuucaagaugagacccauguucgccgugggccugcuguucagaagacugaccagcagagaggugcugcugcugaccaucggccugagccugauggccagcauggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccaugauccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagaccaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaacuucaccgaggugaagggcuacaccagcggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16166 - RNA, 9879 nt, Artificial Sequence
  derived and/or modified CDS sequence (opt4) from DENV-1__GQ199877__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccagcagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16167 - RNA, 9879 nt, Artificial Sequence
  derived and/or modified CDS sequence (opt4) from DENV-1__GU056029__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggugcagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccgcccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16168 - RNA, 9879 nt, Artificial Sequence
  derived and/or modified CDS sequence (opt4) from DENV-1__GU056030__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugagauacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuacacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacaacuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacggcaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggacaaggccgccgaggugagcugggagcaggaggccgagcacagcggcgccagccacaacaucagcguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccugcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgugaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaaccacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacgugaccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16169 - RNA, 9879 nt, Artificial Sequence
  derived and/or modified CDS sequence (opt4) from DENV-1__GU056031__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagcccagcaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgaccccgagggcgcccugugguga

SEQ ID NO: 16170 - RNA, 9879 nt, Artificial Sequence
  derived and/or modified CDS sequence (opt4) from DENV-1__GU056032__SS-prME
agcguggccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcaugcugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaagaucagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacaccgagggcgcccugugguga

SEQ ID NO: 16171 - RNA, 9879 nt, Artificial Sequence
  derived and/or modified CDS sequence (opt4) from DENV-1__GU056033__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccaaggccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaaucagccagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagagccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagaccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccugggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucuggaaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16172 - RNA, 9879 nt, Artificial Sequence
  derived and/or modified CDS sequence (opt4) from DENV-1__GU131833__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccagaacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaucaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacauggccagcaugaagagauucaagaacgagagcgaccccgagggcgcccugugguga

SEQ ID NO: 16173 - RNA, 9879 nt, Artificial Sequence
  derived and/or modified CDS sequence (opt4) from DENV-1__GU131834__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaagacccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguucuucaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16174 - RNA, 9879 nt, Artificial Sequence
  derived and/or modified CDS sequence (opt4) from DENV-1__GU131835__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggugcugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccuggccgaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaugaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugaugcuguucuuccugagcggcaagggccugggcaagaccagcaucggccugcugugcgugaccgccagcagcgcccugcuguggauggccagcguggagccccacuggaucgccgccagcaucgugcuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccaccgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcagaauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccagccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccuggagggcgcccugugguga

SEQ ID NO: 16175 - RNA, 9879 nt, Artificial Sequence
  derived and/or modified CDS sequence (opt4) from DENV-1__GU131836__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggugcagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcugagcagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggugcccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccggccacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16176 - RNA, 9879 nt, Artificial Sequence
  derived and/or modified CDS sequence (opt4) from DENV-1__GU131837__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggaggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16177 - RNA, 9879 nt, Artificial Sequence
  derived and/or modified CDS sequence (opt4) from DENV-1__JN819415__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16178 - RNA, 9879 nt, Artificial Sequence
  derived and/or modified CDS sequence (opt4) from DENV-1__GU131838__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaagaccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16179 - RNA, 9879 nt, Artificial Sequence
  derived and/or modified CDS sequence (opt4) from DENV-1__GU131839__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaccgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggugcagggcaagaagaugaucagaccccagcccauggagcacaaguacagcuggaagagcuggggcaaggccaagaucaucggcgccgacacccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccgcccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccagcgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucagagagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacguguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16180 - RNA, 9879 nt, Artificial Sequence
  derived and/or modified CDS sequence (opt4) from DENV-1__GU131841__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggccuacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16181 - RNA, 9879 nt, Artificial Sequence
  derived and/or modified CDS sequence (opt4) from DENV-1__GQ868601__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccagacuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaagaaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccacccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagagagugcuggacuggcuggagaagcagggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16182 - RNA, 9879 nt, Artificial Sequence
  derived and/or modified CDS sequence (opt4) from DENV-1__EU660390__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugaucgugggcgacguggccggcauccugggccagggcagaaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugguggccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16183 - RNA, 9879 nt, Artificial Sequence
  derived and/or modified CDS sequence (opt4) from DENV-1__EU660391__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggacggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaaguacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16184 - RNA, 9879 nt, Artificial Sequence
  derived and/or modified CDS sequence (opt4) from DENV-1__EU660393__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcaucacccagagcggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacagaagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16185 - RNA, 9879 nt, Artificial Sequence
  derived and/or modified CDS sequence (opt4) from DENV-1__EU660401__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16186 - RNA, 9879 nt, Artificial Sequence
  derived and/or modified CDS sequence (opt4) from DENV-1__FJ373305__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccgugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16187 - RNA, 9879 nt, Artificial Sequence
  derived and/or modified CDS sequence (opt4) from DENV-1__EU660402__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaucgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagaucuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuacgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagccacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugaugcuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16188 - RNA, 9879 nt, Artificial Sequence
  derived and/or modified CDS sequence (opt4) from DENV-1__EU660403__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16189 - RNA, 9879 nt, Artificial Sequence
  derived and/or modified CDS sequence (opt4) from DENV-1__EU660397__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16190 - RNA, 9879 nt, Artificial Sequence
  derived and/or modified CDS sequence (opt4) from DENV-1__EU687247__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagaucuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcugaacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16191 - RNA, 9879 nt, Artificial Sequence
  derived and/or modified CDS sequence (opt4) from DENV-1__EU660412__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaucagcaugaagagauucaagaacgagagcgaccccgagggcgcccugugguga

SEQ ID NO: 16192 - RNA, 9879 nt, Artificial Sequence
  derived and/or modified CDS sequence (opt4) from DENV-1__EU660418__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16193 - RNA, 9879 nt, Artificial Sequence
  derived and/or modified CDS sequence (opt4) from DENV-1__EU677151__SS-prME
agcgugaccaugcugcugaugcugauccccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggcgccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccaugguggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16194 - RNA, 9879 nt, Artificial Sequence
  derived and/or modified CDS sequence (opt4) from DENV-1__EU677152__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16195 - RNA, 9879 nt, Artificial Sequence
  derived and/or modified CDS sequence (opt4) from DENV-1__EU677155__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccggcagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16196 - RNA, 9879 nt, Artificial Sequence
  derived and/or modified CDS sequence (opt4) from DENV-1__EU677157__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16197 - RNA, 9879 nt, Artificial Sequence
  derived and/or modified CDS sequence (opt4) from DENV-1__EU677158__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucgugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16198 - RNA, 9879 nt, Artificial Sequence
  derived and/or modified CDS sequence (opt4) from DENV-1__EU677159__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaucagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaucagcaugaagagauucaagaacgagagcgaccccgagggcgcccugugguga

SEQ ID NO: 16199 - RNA, 9879 nt, Artificial Sequence
  derived and/or modified CDS sequence (opt4) from DENV-1__EU677160__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcuggugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagccuggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16200 - RNA, 9879 nt, Artificial Sequence
  derived and/or modified CDS sequence (opt4) from DENV-1__EU677162__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcagaauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16201 - RNA, 9879 nt, Artificial Sequence
  derived and/or modified CDS sequence (opt4) from DENV-1__EU677164__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaaucgccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaacuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccgugcuguuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccacccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16202 - RNA, 9879 nt, Artificial Sequence
  derived and/or modified CDS sequence (opt4) from DENV-1__EU677165__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaucaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggccacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccuggccagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16203 - RNA, 9879 nt, Artificial Sequence
  derived and/or modified CDS sequence (opt4) from DENV-1__EU677140__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugaagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16204 - RNA, 9879 nt, Artificial Sequence
  derived and/or modified CDS sequence (opt4) from DENV-1__EU677166__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16205 - RNA, 9879 nt, Artificial Sequence
  derived and/or modified CDS sequence (opt4) from DENV-1__EU677170__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggaugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccauccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16206 - RNA, 9879 nt, Artificial Sequence
  derived and/or modified CDS sequence (opt4) from DENV-1__EU677171__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16207 - RNA, 9879 nt, Artificial Sequence
  derived and/or modified CDS sequence (opt4) from DENV-1__EU677172__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaccaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16208 - RNA, 9879 nt, Artificial Sequence
  derived and/or modified CDS sequence (opt4) from DENV-1__EU677173__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccaccaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacgccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16209 - RNA, 9879 nt, Artificial Sequence
  derived and/or modified CDS sequence (opt4) from DENV-1__EU726779__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16210 - RNA, 9879 nt, Artificial Sequence
  derived and/or modified CDS sequence (opt4) from DENV-1__EU677176__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggccuguucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccaagagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagagaaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgacagcgaccccgagggcgcccugugguga

SEQ ID NO: 16211 - RNA, 9879 nt, Artificial Sequence
  derived and/or modified CDS sequence (opt4) from DENV-1__EU726780__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaagacccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggugacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugaucagcgagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16212 - RNA, 9879 nt, Artificial Sequence
  derived and/or modified CDS sequence (opt4) from DENV-1__EU726781__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucguggugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaacuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccgugcuguuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16213 - RNA, 9879 nt, Artificial Sequence
  derived and/or modified CDS sequence (opt4) from DENV-1__EU726782__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16214 - RNA, 9879 nt, Artificial Sequence
  derived and/or modified CDS sequence (opt4) from DENV-1__EU677178__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacaccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16215 - RNA, 9879 nt, Artificial Sequence
  derived and/or modified CDS sequence (opt4) from DENV-1__EU687251__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugaagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16216 - RNA, 9879 nt, Artificial Sequence
  derived and/or modified CDS sequence (opt4) from DENV-1__FJ024427__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccggcuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcgccgacgcccccugcaagauccccuucagcacccaggacgagaagggcaucacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucaacagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16217 - RNA, 9879 nt, Artificial Sequence
  derived and/or modified CDS sequence (opt4) from DENV-1__FJ024428__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16218 - RNA, 9879 nt, Artificial Sequence
  derived and/or modified CDS sequence (opt4) from DENV-1__FJ024429__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugaugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaucgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagagaaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16219 - RNA, 9879 nt, Artificial Sequence
  derived and/or modified CDS sequence (opt4) from DENV-1__FJ024430__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccaugcugcugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgcccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccaccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccguggacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16220 - RNA, 9879 nt, Artificial Sequence
  derived and/or modified CDS sequence (opt4) from DENV-1__FJ024433__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaucagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggaaccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16221 - RNA, 9879 nt, Artificial Sequence
  derived and/or modified CDS sequence (opt4) from DENV-1__FJ024434__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguacaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccgccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaucagcaugaagagauucaagaacgagagcgaccccgagggcgcccugugguga

SEQ ID NO: 16222 - RNA, 9879 nt, Artificial Sequence
  derived and/or modified CDS sequence (opt4) from DENV-1__FJ024435__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucaucuacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16223 - RNA, 9879 nt, Artificial Sequence
  derived and/or modified CDS sequence (opt4) from DENV-1__FJ024436__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgaguacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggacgagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccaugcuggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuacagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaaagagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16224 - RNA, 9879 nt, Artificial Sequence
  derived and/or modified CDS sequence (opt4) from DENV-1__FJ024472__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccgugggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccgugaucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16225 - RNA, 9879 nt, Artificial Sequence
  derived and/or modified CDS sequence (opt4) from DENV-1__FJ024439__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacaggccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16226 - RNA, 9879 nt, Artificial Sequence
  derived and/or modified CDS sequence (opt4) from DENV-1__FJ024441__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaccaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16227 - RNA, 9879 nt, Artificial Sequence
  derived and/or modified CDS sequence (opt4) from DENV-1__FJ024442__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcagaaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaaccugggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16228 - RNA, 9879 nt, Artificial Sequence
  derived and/or modified CDS sequence (opt4) from DENV-1__FJ373296__SS-prME
agcgugaccaugcugcugaugcugaugcccaucgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16229 - RNA, 9879 nt, Artificial Sequence
  derived and/or modified CDS sequence (opt4) from DENV-1__FJ182018__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccaucauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16230 - RNA, 9879 nt, Artificial Sequence
  derived and/or modified CDS sequence (opt4) from DENV-1__FJ410287__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccagccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16231 - RNA, 9879 nt, Artificial Sequence
  derived and/or modified CDS sequence (opt4) from DENV-1__FJ432719__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccgccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16232 - RNA, 9879 nt, Artificial Sequence
  derived and/or modified CDS sequence (opt4) from DENV-1__FJ182020__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16233 - RNA, 9879 nt, Artificial Sequence
  derived and/or modified CDS sequence (opt4) from DENV-1__FJ182022__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16234 - RNA, 9879 nt, Artificial Sequence
  derived and/or modified CDS sequence (opt4) from DENV-1__FJ024447__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagguggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16235 - RNA, 9879 nt, Artificial Sequence
  derived and/or modified CDS sequence (opt4) from DENV-1__FJ182025__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaucgccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccaccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccguggacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16236 - RNA, 9879 nt, Artificial Sequence
  derived and/or modified CDS sequence (opt4) from DENV-1__FJ373297__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggccuguucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccaacagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgacagcgaccccgagggcgcccugugguga

SEQ ID NO: 16237 - RNA, 9879 nt, Artificial Sequence
  derived and/or modified CDS sequence (opt4) from DENV-1__FJ024448__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaucaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgccagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16238 - RNA, 9879 nt, Artificial Sequence
  derived and/or modified CDS sequence (opt4) from DENV-1__FJ182026__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccagaacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacgccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16239 - RNA, 9879 nt, Artificial Sequence
  derived and/or modified CDS sequence (opt4) from DENV-1__FJ182027__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaucaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16240 - RNA, 9879 nt, Artificial Sequence
  derived and/or modified CDS sequence (opt4) from DENV-1__FJ024449__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgacgugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugaagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16241 - RNA, 9879 nt, Artificial Sequence
  derived and/or modified CDS sequence (opt4) from DENV-1__FJ390383__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgagccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16242 - RNA, 9879 nt, Artificial Sequence
  derived and/or modified CDS sequence (opt4) from DENV-1__FJ182033__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccugggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16243 - RNA, 9879 nt, Artificial Sequence
  derived and/or modified CDS sequence (opt4) from DENV-1__FJ182034__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccaugcuggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuacagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16244 - RNA, 9879 nt, Artificial Sequence
  derived and/or modified CDS sequence (opt4) from DENV-1__FJ182036__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggccacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaugagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16245 - RNA, 9879 nt, Artificial Sequence
  derived and/or modified CDS sequence (opt4) from DENV-1__FJ205876__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucaacagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16246 - RNA, 9879 nt, Artificial Sequence
  derived and/or modified CDS sequence (opt4) from DENV-1__FJ024455__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggccccccccccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16247 - RNA, 9879 nt, Artificial Sequence
  derived and/or modified CDS sequence (opt4) from DENV-1__FJ024456__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcauccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggcauggaggagcccauccccauggccaccaacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16248 - RNA, 9879 nt, Artificial Sequence
  derived and/or modified CDS sequence (opt4) from DENV-1__FJ024457__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccauccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16249 - RNA, 9879 nt, Artificial Sequence
  derived and/or modified CDS sequence (opt4) from DENV-1__FJ205881__SS-prME
agcgugaccaugcugcugcugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16250 - RNA, 9879 nt, Artificial Sequence
  derived and/or modified CDS sequence (opt4) from DENV-1__FJ205882__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggacgagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucuggaagguggaggaccacggcuucggcaucuuccccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccaugcuggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuacagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaaagagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16251 - RNA, 9879 nt, Artificial Sequence
  derived and/or modified CDS sequence (opt4) from DENV-1__FJ390388__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugaugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagagaaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16252 - RNA, 9879 nt, Artificial Sequence
  derived and/or modified CDS sequence (opt4) from DENV-1__FJ024464__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgugagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaugagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16253 - RNA, 9879 nt, Artificial Sequence
  derived and/or modified CDS sequence (opt4) from DENV-1__FJ410191__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcagcacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagggcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcuggugcugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaucgaggcccagcugaucagacagauggagagcgaggagaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16254 - RNA, 9879 nt, Artificial Sequence
  derived and/or modified CDS sequence (opt4) from DENV-1__FJ432723__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugaucgccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcuucaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccggcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16255 - RNA, 9879 nt, Artificial Sequence
  derived and/or modified CDS sequence (opt4) from DENV-1__FJ410192__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagccccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16256 - RNA, 9879 nt, Artificial Sequence
  derived and/or modified CDS sequence (opt4) from DENV-1__FJ410194__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcccagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgagcccagaaucaccgacaucauggagcccgagcacgcccugcuggccaagagcaucuucaagcugaccuaccagaacaagguggugagagugcagagccccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucuggagccaccacuuccaccagcugaucaugaaggacggcagagagaucguggugcccugcagaaaccaggacgagcuggugggcagagccagagugagccagggcgccggcuggagccugagagagaccgccugccuggccaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16257 - RNA, 9879 nt, Artificial Sequence
  derived and/or modified CDS sequence (opt4) from DENV-1__FJ432725__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccggcgugaccggcggcgugacccugguguuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggccaagggcuggcccaucagcaagauggacaucggcgugccccugcuggcccugggcugcuacagccaggugaacccccugacccugaccgcccccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggccccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccugggccacagagagagagagcugcacaagcagggcaagugcgccaccugcgugagcaacaugaugggcaagagagagaagaagcugggcgaguucggcaagcccaagggcagcagacccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagcagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16258 - RNA, 9879 nt, Artificial Sequence
  derived and/or modified CDS sequence (opt4) from DENV-1__FJ432729__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccuggccaugcugcugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccagaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16259 - RNA, 9879 nt, Artificial Sequence
  derived and/or modified CDS sequence (opt4) from DENV-1__FJ432730__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaugaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16260 - RNA, 9879 nt, Artificial Sequence
  derived and/or modified CDS sequence (opt4) from DENV-1__FJ432732__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaccaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcaucuucgcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16261 - RNA, 9879 nt, Artificial Sequence
  derived and/or modified CDS sequence (opt4) from DENV-1__FJ432733__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccuggccaugcugcugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccagaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16262 - RNA, 9879 nt, Artificial Sequence
  derived and/or modified CDS sequence (opt4) from DENV-1__FJ410196__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccuucagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcagcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagaggcaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16263 - RNA, 9879 nt, Artificial Sequence
  derived and/or modified CDS sequence (opt4) from DENV-1__FJ432734__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggugcugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcauguucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaccgaccccgagggcgcccugugguga

SEQ ID NO: 16264 - RNA, 9879 nt, Artificial Sequence
  derived and/or modified CDS sequence (opt4) from DENV-1__FJ432735__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16265 - RNA, 9879 nt, Artificial Sequence
  derived and/or modified CDS sequence (opt4) from DENV-1__FJ432736__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuaccugacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggccccggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaucuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16266 - RNA, 9879 nt, Artificial Sequence
  derived and/or modified CDS sequence (opt4) from DENV-1__FJ410198__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16267 - RNA, 9879 nt, Artificial Sequence
  derived and/or modified CDS sequence (opt4) from DENV-1__FJ410199__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaacuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccgugcuguuccugcugaucaugggccagcugaccuggagcgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaaaguaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16268 - RNA, 9879 nt, Artificial Sequence
  derived and/or modified CDS sequence (opt4) from DENV-1__FJ432739__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaaggccuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcauccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaucgaccccgagggcgcccugugguga

SEQ ID NO: 16269 - RNA, 9879 nt, Artificial Sequence
  derived and/or modified CDS sequence (opt4) from DENV-1__FJ410201__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccugaacuacaugaccagcaugaagagauucaagaacgagagcgaccccgagggcgcccugugguga

SEQ ID NO: 16270 - RNA, 9879 nt, Artificial Sequence
  derived and/or modified CDS sequence (opt4) from DENV-1__FJ410203__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16271 - RNA, 9879 nt, Artificial Sequence
  derived and/or modified CDS sequence (opt4) from DENV-1__FJ410204__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgagguguacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagaccaagaagcugagacacagauggcccgacgccagacaguacagcgacccccugggccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16272 - RNA, 9879 nt, Artificial Sequence
  derived and/or modified CDS sequence (opt4) from DENV-1__FJ432742__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16273 - RNA, 9879 nt, Artificial Sequence
  derived and/or modified CDS sequence (opt4) from DENV-1__FJ410205__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16274 - RNA, 9879 nt, Artificial Sequence
  derived and/or modified CDS sequence (opt4) from DENV-1__FJ410207__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucauggugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcuggugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacagaaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16275 - RNA, 9879 nt, Artificial Sequence
  derived and/or modified CDS sequence (opt4) from DENV-1__FJ432744__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaaggccuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcauccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagagaagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaucgaccccgagggcgcccugugguga

SEQ ID NO: 16276 - RNA, 9879 nt, Artificial Sequence
  derived and/or modified CDS sequence (opt4) from DENV-1__FJ547060__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcuggugagacagauggagagcgagggcaucuucagccccugcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16277 - RNA, 9879 nt, Artificial Sequence
  derived and/or modified CDS sequence (opt4) from DENV-1__FJ432745__SS-prME
agcgugaccaugcugcugaugcugaugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16278 - RNA, 9879 nt, Artificial Sequence
  derived and/or modified CDS sequence (opt4) from DENV-1__FJ432746__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacaccaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucgugagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16279 - RNA, 9879 nt, Artificial Sequence
  derived and/or modified CDS sequence (opt4) from DENV-1__FJ432748__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaaggugcccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16280 - RNA, 9879 nt, Artificial Sequence
  derived and/or modified CDS sequence (opt4) from DENV-1__FJ432749__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagaaggccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggcgugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgccuucugguga

SEQ ID NO: 16281 - RNA, 9879 nt, Artificial Sequence
  derived and/or modified CDS sequence (opt4) from DENV-1__FJ410212__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgcccugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucgugacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16282 - RNA, 9879 nt, Artificial Sequence
  derived and/or modified CDS sequence (opt4) from DENV-1__FJ461307__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaucagcaugaagagauucaagaacgagagcgagcccgagggcgcccugugguga

SEQ ID NO: 16283 - RNA, 9879 nt, Artificial Sequence
  derived and/or modified CDS sequence (opt4) from DENV-1__FJ410213__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaaggacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16284 - RNA, 9879 nt, Artificial Sequence
  derived and/or modified CDS sequence (opt4) from DENV-1__FJ461308__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcugcaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16285 - RNA, 9879 nt, Artificial Sequence
  derived and/or modified CDS sequence (opt4) from DENV-1__FJ461310__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagagaaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccaucgaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16286 - RNA, 9879 nt, Artificial Sequence
  derived and/or modified CDS sequence (opt4) from DENV-1__FJ906728__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugauccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggccccuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcugcugagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacaccggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccuggccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16287 - RNA, 9879 nt, Artificial Sequence
  derived and/or modified CDS sequence (opt4) from DENV-1__FJ461313__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgccauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaagcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccugaacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16288 - RNA, 9879 nt, Artificial Sequence
  derived and/or modified CDS sequence (opt4) from DENV-1__FJ547063__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugcagagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16289 - RNA, 9879 nt, Artificial Sequence
  derived and/or modified CDS sequence (opt4) from DENV-1__FJ410218__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucguggagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16290 - RNA, 9879 nt, Artificial Sequence
  derived and/or modified CDS sequence (opt4) from DENV-1__FJ461316__SS-prME
agcgugaccaugcugcugaugcugaugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaugggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16291 - RNA, 9879 nt, Artificial Sequence
  derived and/or modified CDS sequence (opt4) from DENV-1__FJ410220__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucguguucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16292 - RNA, 9879 nt, Artificial Sequence
  derived and/or modified CDS sequence (opt4) from DENV-1__JF937649__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16293 - RNA, 9879 nt, Artificial Sequence
  derived and/or modified CDS sequence (opt4) from DENV-1__FJ410222__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16294 - RNA, 9879 nt, Artificial Sequence
  derived and/or modified CDS sequence (opt4) from DENV-1__FJ461319__SS-prME
agcgugaccaugcugcugaugcugaugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccgccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacgugcagguggccaucaaccaggugagaagacugaucggcaacgagaacuaccuggacuacaugaccagcaugaagagauucaagaacgagagcgaccccgagggcgcccugugguga

SEQ ID NO: 16295 - RNA, 9879 nt, Artificial Sequence
  derived and/or modified CDS sequence (opt4) from DENV-1__FJ461320__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugguggaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaucagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16296 - RNA, 9879 nt, Artificial Sequence
  derived and/or modified CDS sequence (opt4) from DENV-1__FJ410225__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgagaucagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgccagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16297 - RNA, 9879 nt, Artificial Sequence
  derived and/or modified CDS sequence (opt4) from DENV-1__FJ410226__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggacaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcguggugaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugcaugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16298 - RNA, 9879 nt, Artificial Sequence
  derived and/or modified CDS sequence (opt4) from DENV-1__FJ410227__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcaccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16299 - RNA, 9879 nt, Artificial Sequence
  derived and/or modified CDS sequence (opt4) from DENV-1__FJ859029__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcagcacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagggcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcuggugcugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggccaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16300 - RNA, 9879 nt, Artificial Sequence
  derived and/or modified CDS sequence (opt4) from DENV-1__FJ547065__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccugagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaaaguggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16301 - RNA, 9879 nt, Artificial Sequence
  derived and/or modified CDS sequence (opt4) from DENV-1__FJ410230__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaucggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaugagcagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcagaauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagacugaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16302 - RNA, 9879 nt, Artificial Sequence
  derived and/or modified CDS sequence (opt4) from DENV-1__FJ410231__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16303 - RNA, 9879 nt, Artificial Sequence
  derived and/or modified CDS sequence (opt4) from DENV-1__FJ461323__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggugcugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaccgaccccgagggcgcccugugguga

SEQ ID NO: 16304 - RNA, 9879 nt, Artificial Sequence
  derived and/or modified CDS sequence (opt4) from DENV-1__FJ461325__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16305 - RNA, 9879 nt, Artificial Sequence
  derived and/or modified CDS sequence (opt4) from DENV-1__FJ410232__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16306 - RNA, 9879 nt, Artificial Sequence
  derived and/or modified CDS sequence (opt4) from DENV-1__FJ461327__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16307 - RNA, 9879 nt, Artificial Sequence
  derived and/or modified CDS sequence (opt4) from DENV-1__FJ461328__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16308 - RNA, 9879 nt, Artificial Sequence
  derived and/or modified CDS sequence (opt4) from DENV-1__FJ410234__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccagcagccuggaggagcugggcgacggccuggccaugggcaucaugauccugaagcugcugaccgacuuccagagccaccagcugugggccacccugcugagccugaccuucaucaagaccgccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16309 - RNA, 9879 nt, Artificial Sequence
  derived and/or modified CDS sequence (opt4) from DENV-1__FJ410235__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccaccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucgugcccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccaucauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugggcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16310 - RNA, 9879 nt, Artificial Sequence
  derived and/or modified CDS sequence (opt4) from DENV-1__FJ410236__SS-prME
agcgugaccaugcugcugaugcuggugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggccaugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcgugaagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16311 - RNA, 9879 nt, Artificial Sequence
  derived and/or modified CDS sequence (opt4) from DENV-1__FJ410238__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacaccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagaguguacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16312 - RNA, 9879 nt, Artificial Sequence
  derived and/or modified CDS sequence (opt4) from DENV-1__FJ410239__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccguguuccugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16313 - RNA, 9879 nt, Artificial Sequence
  derived and/or modified CDS sequence (opt4) from DENV-1__FJ410240__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgcccacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16314 - RNA, 9879 nt, Artificial Sequence
  derived and/or modified CDS sequence (opt4) from DENV-1__FJ410242__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcaccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16315 - RNA, 9879 nt, Artificial Sequence
  derived and/or modified CDS sequence (opt4) from DENV-1__FJ410243__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaaggccuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggccccaugaagaucaaggacgaggagagagacgacaugcugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugauccugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaucgaccccgagggcgcccugugguga

SEQ ID NO: 16316 - RNA, 9879 nt, Artificial Sequence
  derived and/or modified CDS sequence (opt4) from DENV-1__FJ410244__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagaugaacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaaccugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccaucauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggugcccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16317 - RNA, 9879 nt, Artificial Sequence
  derived and/or modified CDS sequence (opt4) from DENV-1__FJ410245__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaucggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagaagaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16318 - RNA, 9879 nt, Artificial Sequence
  derived and/or modified CDS sequence (opt4) from DENV-1__FJ410246__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggacaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaccgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugcacgaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagagacacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16319 - RNA, 9879 nt, Artificial Sequence
  derived and/or modified CDS sequence (opt4) from DENV-1__FJ410247__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacagaaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagcagggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16320 - RNA, 9879 nt, Artificial Sequence
  derived and/or modified CDS sequence (opt4) from DENV-1__FJ410248__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucguggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccaugcuggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuacagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16321 - RNA, 9879 nt, Artificial Sequence
  derived and/or modified CDS sequence (opt4) from DENV-1__FJ410249__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagagaagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcgugggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcgccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuucuuccugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaccggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16322 - RNA, 9879 nt, Artificial Sequence
  derived and/or modified CDS sequence (opt4) from DENV-1__FJ410251__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcggcaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16323 - RNA, 9879 nt, Artificial Sequence
  derived and/or modified CDS sequence (opt4) from DENV-1__FJ410252__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgacuacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16324 - RNA, 9879 nt, Artificial Sequence
  derived and/or modified CDS sequence (opt4) from DENV-1__FJ461331__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgugguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16325 - RNA, 9879 nt, Artificial Sequence
  derived and/or modified CDS sequence (opt4) from DENV-1__FJ410256__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcaccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugguggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16326 - RNA, 9879 nt, Artificial Sequence
  derived and/or modified CDS sequence (opt4) from DENV-1__FJ410257__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucaccacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuucagcggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaacuacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgacagaaagaagcugagacccagauggcuggacgccagaaccuacagcgacccccuggcccugagagagcugaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16327 - RNA, 9879 nt, Artificial Sequence
  derived and/or modified CDS sequence (opt4) from DENV-1__FJ461332__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgugguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgugaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16328 - RNA, 9879 nt, Artificial Sequence
  derived and/or modified CDS sequence (opt4) from DENV-1__FJ461333__SS-prME
agcgugaccaugcugcugaugcugaugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacgugcagguggccaucaaccaggugagaagacugaucggcaacgagaacuaccuggacuacaugaccagcaugaagagauucaagaacgagagcgaccccgagggcgcccugugguga

SEQ ID NO: 16329 - RNA, 9879 nt, Artificial Sequence
  derived and/or modified CDS sequence (opt4) from DENV-1__FJ410262__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucggccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16330 - RNA, 9879 nt, Artificial Sequence
  derived and/or modified CDS sequence (opt4) from DENV-1__FJ410263__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaucaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16331 - RNA, 9879 nt, Artificial Sequence
  derived and/or modified CDS sequence (opt4) from DENV-1__FJ410264__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16332 - RNA, 9879 nt, Artificial Sequence
  derived and/or modified CDS sequence (opt4) from DENV-1__FJ410265__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16333 - RNA, 9879 nt, Artificial Sequence
  derived and/or modified CDS sequence (opt4) from DENV-1__FJ461336__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcgugcugaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16334 - RNA, 9879 nt, Artificial Sequence
  derived and/or modified CDS sequence (opt4) from DENV-1__FJ410266__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcaagaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugaucgccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcuucaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccggcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16335 - RNA, 9879 nt, Artificial Sequence
  derived and/or modified CDS sequence (opt4) from DENV-1__FJ410269__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagauccccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16336 - RNA, 9879 nt, Artificial Sequence
  derived and/or modified CDS sequence (opt4) from DENV-1__FJ410273__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucguggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccugacccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccaugcuggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuacagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16337 - RNA, 9879 nt, Artificial Sequence
  derived and/or modified CDS sequence (opt4) from DENV-1__FJ410276__SS-prME
agcgugaccauguuccugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccagagccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16338 - RNA, 9879 nt, Artificial Sequence
  derived and/or modified CDS sequence (opt4) from DENV-1__FJ410278__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagagaaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16339 - RNA, 9879 nt, Artificial Sequence
  derived and/or modified CDS sequence (opt4) from DENV-1__FJ410279__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguuccugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaguguacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16340 - RNA, 9879 nt, Artificial Sequence
  derived and/or modified CDS sequence (opt4) from DENV-1__FJ410283__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16341 - RNA, 9879 nt, Artificial Sequence
  derived and/or modified CDS sequence (opt4) from DENV-1__FJ410284__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagaaggacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaccaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16342 - RNA, 9879 nt, Artificial Sequence
  derived and/or modified CDS sequence (opt4) from DENV-1__FJ410285__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcagcacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugagccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggccccggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcuggccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16343 - RNA, 9879 nt, Artificial Sequence
  derived and/or modified CDS sequence (opt4) from DENV-1__FJ410286__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacggcaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16344 - RNA, 9879 nt, Artificial Sequence
  derived and/or modified CDS sequence (opt4) from DENV-1__FJ461339__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagccccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaucgccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgugggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagaccagcaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16345 - RNA, 9879 nt, Artificial Sequence
  derived and/or modified CDS sequence (opt4) from DENV-1__FJ882515__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggccccaggugccccacugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgaggacgaccccgagggcgcccugugguga

SEQ ID NO: 16346 - RNA, 9879 nt, Artificial Sequence
  derived and/or modified CDS sequence (opt4) from DENV-1__FJ882517__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgaggaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggugaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16347 - RNA, 9879 nt, Artificial Sequence
  derived and/or modified CDS sequence (opt4) from DENV-1__JQ287661__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16348 - RNA, 9879 nt, Artificial Sequence
  derived and/or modified CDS sequence (opt4) from DENV-1__FJ882518__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccagcacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16349 - RNA, 9879 nt, Artificial Sequence
  derived and/or modified CDS sequence (opt4) from DENV-1__FJ882519__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaagacacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16350 - RNA, 9879 nt, Artificial Sequence
  derived and/or modified CDS sequence (opt4) from DENV-1__FJ882520__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16351 - RNA, 9879 nt, Artificial Sequence
  derived and/or modified CDS sequence (opt4) from DENV-1__FJ882523__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacgaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16352 - RNA, 9879 nt, Artificial Sequence
  derived and/or modified CDS sequence (opt4) from DENV-1__FJ882524__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuacgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaccgccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16353 - RNA, 9879 nt, Artificial Sequence
  derived and/or modified CDS sequence (opt4) from DENV-1__FJ882525__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugguggccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucagauacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaucggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaacuucgugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16354 - RNA, 9879 nt, Artificial Sequence
  derived and/or modified CDS sequence (opt4) from DENV-1__FJ882526__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagagagcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16355 - RNA, 9879 nt, Artificial Sequence
  derived and/or modified CDS sequence (opt4) from DENV-1__FJ882527__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccaugcuggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccuggccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16356 - RNA, 9879 nt, Artificial Sequence
  derived and/or modified CDS sequence (opt4) from DENV-1__FJ882529__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacgugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggugcacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16357 - RNA, 9879 nt, Artificial Sequence
  derived and/or modified CDS sequence (opt4) from DENV-1__FJ882530__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16358 - RNA, 9879 nt, Artificial Sequence
  derived and/or modified CDS sequence (opt4) from DENV-1__GQ868605__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgacaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugagcaucagcaucaugaucgaggaggugaugagaagcagauggagcagaaagaugcugaugaccggcacccuggccguguuccugcugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccgcccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgagaccgaguaccagaagaccaagaacaacgacugggacuacguggugaccaccgacaucagcgagaugggcgccaacuucagagccgacagagugaucgaccccagaagaugccugaagcccgugauccugaaggacggcagcgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugaucaucgagaucggcaagcugccccagcaccugacccagaaggcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16359 - RNA, 9879 nt, Artificial Sequence
  derived and/or modified CDS sequence (opt4) from DENV-1__FJ882534__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcccccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucguggagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16360 - RNA, 9879 nt, Artificial Sequence
  derived and/or modified CDS sequence (opt4) from DENV-1__FJ882536__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16361 - RNA, 9879 nt, Artificial Sequence
  derived and/or modified CDS sequence (opt4) from DENV-1__FJ882537__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccaccggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagauggugagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcacaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16362 - RNA, 9879 nt, Artificial Sequence
  derived and/or modified CDS sequence (opt4) from DENV-1__GQ868606__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16363 - RNA, 9879 nt, Artificial Sequence
  derived and/or modified CDS sequence (opt4) from DENV-1__FJ882539__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgcccuggccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcaucacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16364 - RNA, 9879 nt, Artificial Sequence
  derived and/or modified CDS sequence (opt4) from DENV-1__FJ882541__SS-prME
agcgugaccaugcugcugaugcugauccccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaagggcaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16365 - RNA, 9879 nt, Artificial Sequence
  derived and/or modified CDS sequence (opt4) from DENV-1__FJ882542__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccagcacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcaugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16366 - RNA, 9879 nt, Artificial Sequence
  derived and/or modified CDS sequence (opt4) from DENV-1__FJ882543__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccgcccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccugggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16367 - RNA, 9879 nt, Artificial Sequence
  derived and/or modified CDS sequence (opt4) from DENV-1__FJ882544__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaagggcaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16368 - RNA, 9879 nt, Artificial Sequence
  derived and/or modified CDS sequence (opt4) from DENV-1__FJ898371__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccagaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16369 - RNA, 9879 nt, Artificial Sequence
  derived and/or modified CDS sequence (opt4) from DENV-1__FJ882545__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16370 - RNA, 9879 nt, Artificial Sequence
  derived and/or modified CDS sequence (opt4) from DENV-1__FJ898372__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccagagacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16371 - RNA, 9879 nt, Artificial Sequence
  derived and/or modified CDS sequence (opt4) from DENV-1__FJ898373__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccaccggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccgugggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagauggugagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcacaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16372 - RNA, 9879 nt, Artificial Sequence
  derived and/or modified CDS sequence (opt4) from DENV-1__FJ898374__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16373 - RNA, 9879 nt, Artificial Sequence
  derived and/or modified CDS sequence (opt4) from DENV-1__FJ898375__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugauggcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagccacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaagcaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16374 - RNA, 9879 nt, Artificial Sequence
  derived and/or modified CDS sequence (opt4) from DENV-1__FJ898376__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccuggccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccagaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaacugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16375 - RNA, 9879 nt, Artificial Sequence
  derived and/or modified CDS sequence (opt4) from DENV-1__FJ898379__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16376 - RNA, 9879 nt, Artificial Sequence
  derived and/or modified CDS sequence (opt4) from DENV-1__GQ199773__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaccgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucuggaaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16377 - RNA, 9879 nt, Artificial Sequence
  derived and/or modified CDS sequence (opt4) from DENV-1__JF937596__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16378 - RNA, 9879 nt, Artificial Sequence
  derived and/or modified CDS sequence (opt4) from DENV-1__FJ898380__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16379 - RNA, 9879 nt, Artificial Sequence
  derived and/or modified CDS sequence (opt4) from DENV-1__FJ898382__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccuucagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcagcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16380 - RNA, 9879 nt, Artificial Sequence
  derived and/or modified CDS sequence (opt4) from DENV-1__FJ898383__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccaucaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16381 - RNA, 9879 nt, Artificial Sequence
  derived and/or modified CDS sequence (opt4) from DENV-1__FJ898384__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccaucuuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16382 - RNA, 9879 nt, Artificial Sequence
  derived and/or modified CDS sequence (opt4) from DENV-1__FJ898385__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcggcguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaugggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16383 - RNA, 9879 nt, Artificial Sequence
  derived and/or modified CDS sequence (opt4) from DENV-1__GQ868608__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaaggccuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccuggaaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacaugcugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaucgaccccgagggcgcccugugguga

SEQ ID NO: 16384 - RNA, 9879 nt, Artificial Sequence
  derived and/or modified CDS sequence (opt4) from DENV-1__GQ199774__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccaccggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagauggugagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugagagagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcacaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16385 - RNA, 9879 nt, Artificial Sequence
  derived and/or modified CDS sequence (opt4) from DENV-1__GQ199775__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccaccggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagauggugagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugagagagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcacaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucuggaccagagaggaggugaccagaaaggugagaagcaacgccggcaucggcgccggcgugggcgacgagaaccaguggaacagcgccaagaagggcguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16386 - RNA, 9876 nt, Artificial Sequence
  derived and/or modified CDS sequence (opt4) from DENV-1__FJ882546__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaaagagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgagcugcaccugggccagcagagaguguucaaggagaagguggacaccagaacccccagagccaagagaggcaccgcccagaucauggagaugaccgccagauggcuguggggcuuccugagcagaaacaagauccccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16387 - RNA, 9879 nt, Artificial Sequence
  derived and/or modified CDS sequence (opt4) from DENV-1__KF921935__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaaggagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16388 - RNA, 9879 nt, Artificial Sequence
  derived and/or modified CDS sequence (opt4) from DENV-1__GQ199776__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggugguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16389 - RNA, 9879 nt, Artificial Sequence
  derived and/or modified CDS sequence (opt4) from DENV-1__GQ199777__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggccuguucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcuggccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16390 - RNA, 9879 nt, Artificial Sequence
  derived and/or modified CDS sequence (opt4) from DENV-1__GQ199778__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggaggccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccaucaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16391 - RNA, 9879 nt, Artificial Sequence
  derived and/or modified CDS sequence (opt4) from DENV-1__GQ199780__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16392 - RNA, 9879 nt, Artificial Sequence
  derived and/or modified CDS sequence (opt4) from DENV-1__GQ199781__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucaucagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccagaagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16393 - RNA, 9879 nt, Artificial Sequence
  derived and/or modified CDS sequence (opt4) from DENV-1__GQ199782__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacauccagaacaccaccuucaucaucgacggccccaacacccccgagugccccgacgaccagagagccuggaacaucugggagguggaggacuacggcuucggcaucuucaccaccaacaucuggcugagacugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugguggaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaucagacccauguucgccgugggccugcuggugagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaugaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16394 - RNA, 9879 nt, Artificial Sequence
  derived and/or modified CDS sequence (opt4) from DENV-1__GQ199783__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggcaccagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcagcaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaucagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcaccacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16395 - RNA, 9879 nt, Artificial Sequence
  derived and/or modified CDS sequence (opt4) from DENV-1__GQ199784__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccuggccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccagaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16396 - RNA, 9879 nt, Artificial Sequence
  derived and/or modified CDS sequence (opt4) from DENV-1__GQ199785__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucaugaagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16397 - RNA, 9879 nt, Artificial Sequence
  derived and/or modified CDS sequence (opt4) from DENV-1__GQ199786__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugauccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16398 - RNA, 9879 nt, Artificial Sequence
  derived and/or modified CDS sequence (opt4) from DENV-1__GQ199787__SS-prME
agcgugaccaugcugcugaugcuggugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguuccugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaacgaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16399 - RNA, 9879 nt, Artificial Sequence
  derived and/or modified CDS sequence (opt4) from DENV-1__GQ199788__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16400 - RNA, 9879 nt, Artificial Sequence
  derived and/or modified CDS sequence (opt4) from DENV-1__GQ199789__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcagcacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagggcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcuggugcugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaucgaggcccagcugaucagacagauggagagcgaggagaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16401 - RNA, 9879 nt, Artificial Sequence
  derived and/or modified CDS sequence (opt4) from DENV-1__GQ199790__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccuggccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccagaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16402 - RNA, 9879 nt, Artificial Sequence
  derived and/or modified CDS sequence (opt4) from DENV-1__GQ199791__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggcgugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgccuucugguga

SEQ ID NO: 16403 - RNA, 9879 nt, Artificial Sequence
  derived and/or modified CDS sequence (opt4) from DENV-1__GQ199792__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacgccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaugggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccggcgacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16404 - RNA, 9879 nt, Artificial Sequence
  derived and/or modified CDS sequence (opt4) from DENV-1__GQ199793__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccaccaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacgccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16405 - RNA, 9879 nt, Artificial Sequence
  derived and/or modified CDS sequence (opt4) from DENV-1__GQ199795__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggaccccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16406 - RNA, 9873 nt, Artificial Sequence
  derived and/or modified CDS sequence (opt4) from DENV-1__FJ882547__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaucggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagggcaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccaugagccccaucgccaugaccgacaccaccccccuggcccagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16407 - RNA, 9879 nt, Artificial Sequence
  derived and/or modified CDS sequence (opt4) from DENV-1__GQ199797__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagaccaugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16408 - RNA, 9879 nt, Artificial Sequence
  derived and/or modified CDS sequence (opt4) from DENV-1__GQ199799__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagccccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16409 - RNA, 9879 nt, Artificial Sequence
  derived and/or modified CDS sequence (opt4) from DENV-1__GQ199800__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16410 - RNA, 9879 nt, Artificial Sequence
  derived and/or modified CDS sequence (opt4) from DENV-1__FJ882548__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16411 - RNA, 9879 nt, Artificial Sequence
  derived and/or modified CDS sequence (opt4) from DENV-1__GQ199801__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccagacuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcaagaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccaugcuggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuacagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcauccccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16412 - RNA, 9879 nt, Artificial Sequence
  derived and/or modified CDS sequence (opt4) from DENV-1__GQ199802__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggguguuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16413 - RNA, 9879 nt, Artificial Sequence
  derived and/or modified CDS sequence (opt4) from DENV-1__JF937597__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgccauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccugaacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16414 - RNA, 9879 nt, Artificial Sequence
  derived and/or modified CDS sequence (opt4) from DENV-1__GQ868609__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugagacugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16415 - RNA, 9879 nt, Artificial Sequence
  derived and/or modified CDS sequence (opt4) from DENV-1__GQ199803__SS-prME
agcgugaccaugcugcugaugcugaugcccaccgcccuggccuuccaccugaccaucagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccagcagccuggaggagcugggcgacggccuggccaugggcaucaugauccugaagcugcugaccgacuuccagagccaccagcugugggccacccugcugagccugaccuucaucaagaccgccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgacagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16416 - RNA, 9879 nt, Artificial Sequence
  derived and/or modified CDS sequence (opt4) from DENV-1__GQ199804__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgacgccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16417 - RNA, 9879 nt, Artificial Sequence
  derived and/or modified CDS sequence (opt4) from DENV-1__GQ199805__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccuggccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccagaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16418 - RNA, 9879 nt, Artificial Sequence
  derived and/or modified CDS sequence (opt4) from DENV-1__GQ199806__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggccguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucguggugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggacggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugaacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaaguacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16419 - RNA, 9879 nt, Artificial Sequence
  derived and/or modified CDS sequence (opt4) from DENV-1__GQ199809__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaacugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16420 - RNA, 9879 nt, Artificial Sequence
  derived and/or modified CDS sequence (opt4) from DENV-1__GQ199810__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggagguggagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16421 - RNA, 9879 nt, Artificial Sequence
  derived and/or modified CDS sequence (opt4) from DENV-1__GQ199811__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucgugagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16422 - RNA, 9879 nt, Artificial Sequence
  derived and/or modified CDS sequence (opt4) from DENV-1__FJ882549__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagagugcugaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16423 - RNA, 9879 nt, Artificial Sequence
  derived and/or modified CDS sequence (opt4) from DENV-1__GQ199814__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggacaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaccgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16424 - RNA, 9879 nt, Artificial Sequence
  derived and/or modified CDS sequence (opt4) from DENV-1__GQ199816__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaaggccuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcauccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaucgaccccgagggcgcccugugguga

SEQ ID NO: 16425 - RNA, 9879 nt, Artificial Sequence
  derived and/or modified CDS sequence (opt4) from DENV-1__GQ199817__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggugcuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguuccugcugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16426 - RNA, 9879 nt, Artificial Sequence
  derived and/or modified CDS sequence (opt4) from DENV-1__FJ882550__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaugaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16427 - RNA, 9879 nt, Artificial Sequence
  derived and/or modified CDS sequence (opt4) from DENV-1__FJ882551__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaucggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagccacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcaggagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcugaagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagcugguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16428 - RNA, 9879 nt, Artificial Sequence
  derived and/or modified CDS sequence (opt4) from DENV-1__FJ882552__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccagcagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaaccacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16429 - RNA, 9879 nt, Artificial Sequence
  derived and/or modified CDS sequence (opt4) from DENV-1__FJ882553__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucagaaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgagcccgagggcgcccugugguga

SEQ ID NO: 16430 - RNA, 9879 nt, Artificial Sequence
  derived and/or modified CDS sequence (opt4) from DENV-1__FJ882554__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccuacagcaucgccgccagaggcuacaucagcaccagagugggcaugggcgaggccgccgccaucuucaugaccgccaccccccccggcagcguggaggccuucccccagagcaacgccgugaucaaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16431 - RNA, 9879 nt, Artificial Sequence
  derived and/or modified CDS sequence (opt4) from DENV-1__GQ868610__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugaucgccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcuucaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16432 - RNA, 9879 nt, Artificial Sequence
  derived and/or modified CDS sequence (opt4) from DENV-1__GQ868611__SS-prME
agcgugaccauguuccugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccagagccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16433 - RNA, 9879 nt, Artificial Sequence
  derived and/or modified CDS sequence (opt4) from DENV-1__FJ882555__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcgccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccagaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagguggugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16434 - RNA, 9879 nt, Artificial Sequence
  derived and/or modified CDS sequence (opt4) from DENV-1__GQ199821__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucguggugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggaucgccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16435 - RNA, 9879 nt, Artificial Sequence
  derived and/or modified CDS sequence (opt4) from DENV-1__FJ882556__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugagcgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16436 - RNA, 9879 nt, Artificial Sequence
  derived and/or modified CDS sequence (opt4) from DENV-1__GQ199822__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcagagccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgcccuggugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16437 - RNA, 9879 nt, Artificial Sequence
  derived and/or modified CDS sequence (opt4) from DENV-1__FJ882557__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugaccaugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16438 - RNA, 9879 nt, Artificial Sequence
  derived and/or modified CDS sequence (opt4) from DENV-1__FJ882558__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcugaccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagaccaugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16439 - RNA, 9879 nt, Artificial Sequence
  derived and/or modified CDS sequence (opt4) from DENV-1__GQ199824__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagauccugaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16440 - RNA, 9879 nt, Artificial Sequence
  derived and/or modified CDS sequence (opt4) from DENV-1__FJ882559__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccagaaucaucggcgccgacgugcagaacaccaccuucaucaucgacggccccaacacccccgagugccccgacgaccagagagccuggaacaucugggagguggaggacuacggcuucggcaucuucaccaccaacaucuggcugagacugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucgugcacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugagacugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16441 - RNA, 9879 nt, Artificial Sequence
  derived and/or modified CDS sequence (opt4) from DENV-1__GQ199828__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugagagagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaucggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaagaacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgacaaggccaucggcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16442 - RNA, 9879 nt, Artificial Sequence
  derived and/or modified CDS sequence (opt4) from DENV-1__GQ199829__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16443 - RNA, 9879 nt, Artificial Sequence
  derived and/or modified CDS sequence (opt4) from DENV-1__FJ882562__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaugaccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16444 - RNA, 9879 nt, Artificial Sequence
  derived and/or modified CDS sequence (opt4) from DENV-1__FJ882564__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccaugguggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16445 - RNA, 9879 nt, Artificial Sequence
  derived and/or modified CDS sequence (opt4) from DENV-1__FJ882565__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagaggcagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16446 - RNA, 9879 nt, Artificial Sequence
  derived and/or modified CDS sequence (opt4) from DENV-1__FJ882567__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16447 - RNA, 9879 nt, Artificial Sequence
  derived and/or modified CDS sequence (opt4) from DENV-1__GQ199831__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgaccccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16448 - RNA, 9879 nt, Artificial Sequence
  derived and/or modified CDS sequence (opt4) from DENV-1__GQ199832__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacaagcacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga
